United States Patent 12,297,469 (METHODS AND COMPOSITIONS FOR INHIBITING ADAM10 BIOLOGICAL ACTIVITIES) - sequence listing, part 5

SEQ ID NO: 32577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 32578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 32579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 32580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 32581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 32582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 32583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 32584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 32585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 32586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 32587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 32588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 32589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 32590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 32591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 32592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 32593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 32594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 32595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 32596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 32597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 32598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 32599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 32600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 32601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 32602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 32603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 32604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 32605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 32606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 32607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 32608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 32609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 32610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 32611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 32612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 32613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 32614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 32615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 32616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 32617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 32618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 32619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 32620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 32621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 32622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 32623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 32624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 32625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 32626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 32627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 32628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 32629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 32630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 32631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 32632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 32633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 32634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 32635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 32636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 32637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 32638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 32639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 32640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 32641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 32642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 32643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 32644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 32645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 32646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 32647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 32648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 32649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 32650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 32651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 32652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 32653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 32654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 32655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 32656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 32657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 32658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 32659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 32660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 32661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 32662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 32663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 32664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 32665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 32666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 32667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 32668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 32669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 32670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 32671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 32672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 32673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 32674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 32675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 32676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 32677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 32678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 32679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 32680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 32681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 32682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 32683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 32684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 32685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 32686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 32687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 32688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 32689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 32690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 32691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 32692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 32693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 32694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 32695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 32696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 32697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 32698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 32699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 32700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 32701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 32702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 32703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 32704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 32705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 32706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 32707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 32708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 32709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 32710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 32711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 32712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 32713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 32714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 32715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 32716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 32717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 32718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 32719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 32720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 32721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 32722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 32723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 32724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 32725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 32726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 32727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 32728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 32729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 32730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 32731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 32732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 32733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 32734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 32735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 32736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 32737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 32738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 32739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 32740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 32741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 32742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 32743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 32744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 32745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 32746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 32747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 32748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 32749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 32750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 32751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 32752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 32753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 32754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 32755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 32756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 32757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 32758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 32759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 32760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 32761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 32762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 32763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 32764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 32765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 32766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 32767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 32768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 32769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 32770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 32771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 32772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 32773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 32774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 32775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 32776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 32777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 32778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 32779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 32780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 32781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 32782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 32783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 32784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 32785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 32786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 32787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 32788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 32789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 32790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 32791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 32792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 32793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 32794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 32795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 32796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 32797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 32798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 32799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 32800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 32801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 32802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 32803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 32804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 32805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 32806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 32807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 32808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 32809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 32810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 32811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 32812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 32813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 32814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 32815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 32816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 32817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 32818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 32819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 32820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 32821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 32822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 32823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 32824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 32825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 32826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 32827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 32828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 32829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 32830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 32831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 32832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 32833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 32834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 32835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 32836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 32837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 32838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 32839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 32840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 32841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 32842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 32843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 32844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 32845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 32846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 32847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 32848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 32849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 32850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 32851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 32852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 32853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 32854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 32855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 32856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 32857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 32858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 32859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 32860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 32861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 32862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 32863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 32864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 32865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 32866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 32867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 32868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 32869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 32870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 32871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 32872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 32873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 32874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 32875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 32876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 32877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 32878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 32879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 32880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 32881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 32882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 32883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 32884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 32885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 32886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 32887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 32888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 32889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 32890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 32891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 32892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 32893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 32894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 32895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 32896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 32897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 32898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 32899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 32900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 32901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 32902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 32903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 32904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 32905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 32906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 32907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 32908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 32909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 32910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 32911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 32912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 32913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 32914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 32915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 32916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 32917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 32918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 32919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 32920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 32921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 32922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 32923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 32924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 32925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 32926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 32927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 32928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 32929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 32930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 32931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 32932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 32933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 32934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 32935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 32936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 32937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 32938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 32939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 32940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 32941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 32942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 32943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 32944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 32945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 32946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 32947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 32948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 32949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 32950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 32951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 32952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 32953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 32954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 32955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 32956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 32957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 32958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 32959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 32960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 32961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 32962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 32963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 32964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 32965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 32966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 32967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 32968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 32969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 32970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 32971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 32972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 32973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 32974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 32975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 32976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 32977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 32978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 32979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 32980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 32981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 32982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 32983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 32984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 32985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 32986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 32987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 32988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 32989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 32990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 32991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 32992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 32993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 32994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 32995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 32996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 32997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 32998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 32999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 33000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 33001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 33002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 33003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 33004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 33005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 33006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 33007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 33008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 33009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 33010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 33011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 33012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 33013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 33014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 33015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 33016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 33017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 33018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 33019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 33020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 33021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 33022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 33023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 33024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 33025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 33026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 33027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 33028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 33029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 33030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 33031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 33032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 33033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 33034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 33035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 33036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 33037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 33038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 33039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 33040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 33041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 33042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 33043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 33044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 33045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 33046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 33047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 33048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 33049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 33050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 33051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 33052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 33053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 33054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 33055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 33056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 33057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 33058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 33059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 33060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 33061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 33062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 33063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 33064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 33065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 33066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 33067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 33068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 33069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 33070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 33071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 33072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 33073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 33074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 33075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 33076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 33077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 33078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 33079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 33080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 33081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 33082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 33083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 33084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 33085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 33086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 33087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 33088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 33089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 33090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 33091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 33092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 33093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 33094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 33095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 33096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 33097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 33098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 33099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 33100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 33101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 33102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 33103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 33104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 33105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 33106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 33107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 33108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 33109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 33110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 33111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 33112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 33113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 33114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 33115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 33116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 33117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 33118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 33119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 33120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 33121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 33122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 33123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 33124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 33125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 33126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 33127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 33128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 33129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 33130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 33131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 33132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 33133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 33134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 33135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 33136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 33137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 33138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 33139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 33140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 33141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 33142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 33143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 33144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 33145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 33146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 33147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 33148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 33149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 33150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 33151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 33152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 33153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 33154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 33155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 33156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 33157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 33158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 33159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 33160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 33161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 33162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 33163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 33164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 33165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 33166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 33167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 33168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 33169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 33170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 33171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 33172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 33173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 33174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 33175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 33176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 33177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 33178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 33179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 33180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 33181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 33182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 33183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 33184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 33185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 33186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 33187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 33188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 33189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 33190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 33191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 33192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 33193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 33194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 33195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 33196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 33197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 33198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 33199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 33200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 33201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 33202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 33203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 33204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 33205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 33206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 33207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 33208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 33209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 33210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 33211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 33212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 33213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 33214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 33215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 33216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 33217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 33218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 33219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 33220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 33221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 33222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 33223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 33224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 33225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 33226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 33227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 33228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 33229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 33230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 33231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 33232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 33233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 33234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 33235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 33236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 33237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 33238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 33239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 33240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 33241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 33242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 33243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 33244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 33245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 33246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 33247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 33248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 33249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 33250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 33251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 33252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 33253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 33254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 33255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 33256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 33257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 33258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 33259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 33260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 33261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 33262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 33263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 33264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 33265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 33266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 33267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 33268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 33269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 33270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 33271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 33272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 33273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 33274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 33275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 33276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 33277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 33278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 33279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 33280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 33281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 33282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 33283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 33284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 33285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 33286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 33287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 33288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 33289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 33290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 33291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 33292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 33293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 33294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 33295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 33296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 33297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 33298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 33299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 33300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 33301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 33302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 33303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 33304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 33305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 33306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 33307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 33308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 33309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 33310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 33311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 33312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 33313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 33314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 33315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 33316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 33317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 33318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 33319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 33320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 33321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 33322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 33323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 33324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 33325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 33326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 33327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 33328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 33329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 33330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 33331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 33332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 33333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 33334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 33335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 33336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 33337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 33338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 33339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 33340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 33341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 33342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 33343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 33344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 33345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 33346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 33347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 33348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 33349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 33350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 33351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 33352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 33353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 33354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 33355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 33356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 33357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 33358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 33359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 33360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 33361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 33362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 33363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 33364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 33365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 33366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 33367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 33368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 33369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 33370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 33371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 33372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 33373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 33374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 33375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 33376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 33377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 33378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 33379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 33380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 33381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 33382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 33383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 33384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 33385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 33386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 33387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 33388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 33389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 33390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 33391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 33392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 33393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 33394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 33395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 33396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 33397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 33398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 33399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 33400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 33401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 33402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 33403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 33404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 33405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 33406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 33407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 33408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 33409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 33410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 33411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 33412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 33413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 33414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 33415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 33416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 33417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 33418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 33419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 33420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 33421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 33422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 33423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 33424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 33425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 33426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 33427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 33428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 33429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 33430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 33431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 33432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 33433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 33434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 33435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 33436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 33437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 33438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 33439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 33440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 33441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 33442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 33443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 33444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 33445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 33446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 33447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 33448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 33449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 33450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 33451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 33452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 33453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 33454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 33455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 33456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 33457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 33458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 33459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 33460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 33461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 33462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 33463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 33464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 33465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 33466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 33467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 33468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 33469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 33470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 33471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 33472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 33473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 33474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 33475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 33476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 33477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 33478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 33479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 33480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 33481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 33482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 33483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 33484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 33485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 33486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 33487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 33488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 33489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 33490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 33491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 33492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 33493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 33494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 33495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 33496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 33497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 33498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 33499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 33500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 33501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 33502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 33503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 33504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 33505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 33506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 33507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 33508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 33509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 33510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 33511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 33512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 33513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 33514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 33515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 33516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 33517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 33518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 33519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 33520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 33521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 33522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 33523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 33524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 33525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 33526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 33527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 33528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 33529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 33530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 33531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 33532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 33533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 33534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 33535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 33536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 33537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 33538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 33539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 33540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 33541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 33542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 33543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 33544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 33545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 33546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 33547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 33548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 33549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 33550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 33551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 33552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 33553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 33554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 33555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 33556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 33557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 33558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 33559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 33560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 33561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 33562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 33563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 33564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 33565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 33566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 33567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 33568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 33569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 33570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 33571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 33572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 33573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 33574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 33575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 33576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 33577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 33578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 33579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 33580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 33581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 33582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 33583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 33584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 33585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 33586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 33587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 33588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 33589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 33590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 33591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 33592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 33593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 33594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 33595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 33596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 33597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 33598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 33599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 33600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 33601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 33602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 33603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 33604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 33605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 33606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 33607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 33608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 33609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 33610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 33611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 33612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 33613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 33614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 33615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 33616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 33617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 33618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 33619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 33620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 33621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 33622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 33623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 33624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 33625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 33626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 33627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 33628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 33629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 33630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 33631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 33632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 33633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 33634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 33635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 33636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 33637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 33638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 33639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 33640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 33641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 33642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 33643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 33644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 33645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 33646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 33647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 33648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 33649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 33650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 33651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 33652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 33653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 33654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 33655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 33656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 33657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 33658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 33659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 33660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 33661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 33662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 33663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 33664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 33665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 33666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 33667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 33668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 33669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 33670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 33671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 33672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 33673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 33674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 33675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 33676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 33677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 33678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 33679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 33680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 33681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 33682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 33683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 33684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 33685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 33686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 33687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 33688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 33689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 33690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 33691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 33692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 33693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 33694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 33695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 33696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 33697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 33698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 33699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 33700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 33701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 33702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 33703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 33704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 33705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 33706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 33707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 33708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 33709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 33710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 33711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 33712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 33713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 33714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 33715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 33716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 33717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 33718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 33719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 33720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 33721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 33722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 33723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 33724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 33725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 33726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 33727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 33728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 33729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 33730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 33731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 33732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 33733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 33734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 33735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 33736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 33737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 33738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 33739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 33740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 33741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 33742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 33743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 33744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 33745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 33746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 33747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 33748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 33749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 33750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 33751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 33752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 33753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 33754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 33755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 33756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 33757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 33758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 33759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 33760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 33761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 33762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 33763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 33764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 33765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 33766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 33767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 33768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 33769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 33770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 33771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 33772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 33773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 33774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 33775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 33776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 33777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 33778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 33779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 33780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 33781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 33782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 33783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 33784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 33785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 33786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 33787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 33788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 33789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 33790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 33791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 33792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 33793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 33794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 33795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 33796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 33797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 33798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 33799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 33800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 33801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 33802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 33803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 33804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 33805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 33806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 33807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 33808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 33809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 33810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 33811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 33812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 33813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 33814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 33815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 33816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 33817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 33818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 33819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 33820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 33821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 33822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 33823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 33824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 33825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 33826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 33827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 33828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 33829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 33830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 33831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 33832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 33833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 33834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 33835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 33836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 33837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 33838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 33839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 33840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 33841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 33842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 33843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 33844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 33845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 33846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 33847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 33848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 33849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 33850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 33851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 33852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 33853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 33854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 33855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 33856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 33857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 33858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 33859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 33860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 33861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 33862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 33863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 33864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 33865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 33866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 33867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 33868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 33869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 33870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 33871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 33872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 33873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 33874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 33875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 33876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 33877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 33878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 33879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 33880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 33881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 33882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 33883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 33884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 33885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 33886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 33887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 33888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 33889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 33890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 33891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 33892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 33893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 33894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 33895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 33896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 33897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 33898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 33899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 33900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 33901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 33902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 33903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 33904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 33905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 33906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 33907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 33908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 33909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 33910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 33911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 33912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 33913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 33914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 33915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 33916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 33917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 33918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 33919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 33920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 33921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 33922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 33923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 33924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 33925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 33926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 33927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 33928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 33929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 33930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 33931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 33932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 33933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 33934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 33935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 33936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 33937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 33938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 33939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 33940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 33941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 33942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 33943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 33944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 33945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 33946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 33947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 33948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 33949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 33950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 33951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 33952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 33953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 33954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 33955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 33956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 33957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 33958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 33959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 33960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 33961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 33962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 33963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 33964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 33965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 33966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 33967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 33968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 33969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 33970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 33971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 33972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 33973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 33974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 33975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 33976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 33977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 33978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 33979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 33980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 33981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 33982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 33983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 33984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 33985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 33986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 33987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 33988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 33989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 33990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 33991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 33992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 33993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 33994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 33995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 33996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 33997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 33998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 33999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 34000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 34001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 34002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 34003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 34004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 34005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 34006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 34007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 34008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 34009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 34010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 34011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 34012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 34013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 34014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 34015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 34016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 34017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 34018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 34019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 34020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 34021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 34022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 34023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 34024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 34025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 34026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 34027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 34028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 34029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 34030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 34031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 34032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 34033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 34034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 34035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 34036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 34037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 34038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 34039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 34040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 34041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 34042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 34043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 34044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 34045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 34046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 34047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 34048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 34049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 34050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 34051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 34052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 34053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 34054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 34055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 34056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 34057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 34058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 34059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 34060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 34061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 34062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 34063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 34064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 34065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 34066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 34067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 34068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 34069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 34070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 34071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 34072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 34073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 34074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 34075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 34076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 34077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 34078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 34079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 34080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 34081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 34082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 34083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 34084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 34085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 34086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 34087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 34088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 34089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 34090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 34091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 34092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 34093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 34094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 34095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 34096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 34097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 34098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 34099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 34100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 34101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 34102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 34103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 34104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 34105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 34106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 34107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 34108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 34109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 34110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 34111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 34112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 34113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 34114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 34115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 34116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 34117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 34118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 34119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 34120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 34121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 34122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 34123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 34124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 34125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 34126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 34127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 34128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 34129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 34130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 34131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 34132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 34133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 34134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 34135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 34136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 34137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 34138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 34139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 34140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 34141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 34142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 34143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 34144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 34145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 34146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 34147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 34148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 34149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 34150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 34151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 34152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 34153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 34154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 34155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 34156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 34157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 34158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 34159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 34160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 34161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 34162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 34163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 34164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 34165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 34166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 34167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 34168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 34169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 34170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 34171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 34172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 34173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 34174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 34175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 34176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 34177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 34178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 34179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 34180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 34181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 34182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 34183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 34184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 34185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 34186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 34187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 34188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 34189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 34190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 34191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 34192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 34193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 34194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 34195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 34196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 34197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 34198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 34199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 34200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 34201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 34202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 34203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 34204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 34205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 34206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 34207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 34208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 34209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 34210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 34211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 34212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 34213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 34214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 34215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 34216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 34217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 34218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 34219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 34220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 34221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 34222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 34223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 34224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 34225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 34226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 34227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 34228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 34229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 34230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 34231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 34232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 34233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 34234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 34235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 34236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 34237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 34238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 34239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 34240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 34241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 34242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 34243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 34244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 34245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 34246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 34247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 34248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 34249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 34250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 34251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 34252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 34253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 34254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 34255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 34256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 34257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 34258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 34259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 34260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 34261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 34262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 34263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 34264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 34265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 34266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 34267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 34268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 34269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 34270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 34271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 34272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 34273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 34274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 34275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 34276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 34277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 34278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 34279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 34280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 34281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 34282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 34283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 34284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 34285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 34286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 34287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 34288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 34289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 34290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 34291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 34292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 34293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 34294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 34295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 34296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 34297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 34298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 34299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 34300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 34301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 34302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 34303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 34304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 34305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 34306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 34307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 34308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 34309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 34310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 34311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 34312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 34313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 34314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 34315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 34316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 34317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 34318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 34319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 34320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 34321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 34322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 34323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 34324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 34325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 34326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 34327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 34328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 34329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 34330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 34331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 34332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 34333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 34334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 34335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 34336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 34337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 34338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 34339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 34340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 34341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 34342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 34343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 34344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 34345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 34346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 34347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 34348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 34349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 34350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 34351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 34352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 34353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 34354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 34355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 34356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 34357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 34358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 34359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 34360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 34361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 34362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 34363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 34364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 34365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 34366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 34367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 34368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 34369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 34370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 34371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 34372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 34373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 34374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 34375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 34376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 34377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 34378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 34379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 34380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 34381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 34382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 34383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 34384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 34385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 34386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 34387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 34388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 34389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 34390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 34391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 34392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 34393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 34394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 34395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 34396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 34397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 34398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 34399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 34400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 34401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 34402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 34403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 34404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 34405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 34406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 34407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 34408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 34409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 34410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 34411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 34412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 34413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 34414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 34415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 34416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 34417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 34418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 34419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 34420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 34421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 34422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 34423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 34424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 34425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 34426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 34427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 34428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 34429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 34430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 34431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 34432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 34433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 34434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 34435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 34436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 34437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 34438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 34439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 34440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 34441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 34442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 34443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 34444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 34445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 34446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 34447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 34448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 34449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 34450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 34451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 34452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 34453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 34454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 34455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 34456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 34457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 34458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 34459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 34460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 34461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 34462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 34463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 34464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 34465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 34466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 34467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 34468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 34469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 34470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 34471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 34472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 34473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 34474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 34475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 34476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 34477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 34478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 34479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 34480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 34481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 34482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 34483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 34484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 34485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 34486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 34487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 34488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 34489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 34490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 34491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 34492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 34493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 34494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 34495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 34496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 34497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 34498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 34499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 34500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 34501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 34502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 34503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 34504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 34505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 34506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 34507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 34508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 34509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 34510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 34511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 34512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 34513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 34514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 34515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 34516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 34517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 34518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 34519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 34520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 34521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 34522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 34523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 34524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 34525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 34526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 34527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 34528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 34529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 34530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 34531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 34532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 34533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 34534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 34535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 34536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 34537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 34538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 34539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 34540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 34541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 34542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 34543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 34544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 34545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 34546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 34547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 34548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 34549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 34550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 34551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 34552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 34553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 34554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 34555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 34556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 34557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 34558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 34559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 34560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 34561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 34562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 34563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 34564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 34565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 34566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 34567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 34568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 34569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 34570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 34571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 34572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 34573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 34574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 34575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 34576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 34577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 34578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 34579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 34580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 34581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 34582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 34583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 34584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 34585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 34586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 34587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 34588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 34589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 34590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 34591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 34592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 34593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 34594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 34595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 34596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 34597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 34598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 34599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 34600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 34601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 34602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 34603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 34604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 34605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 34606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 34607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 34608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 34609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 34610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 34611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 34612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 34613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 34614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 34615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 34616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 34617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 34618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 34619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 34620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 34621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 34622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 34623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 34624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 34625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 34626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 34627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 34628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 34629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 34630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 34631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 34632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 34633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 34634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 34635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 34636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 34637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 34638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 34639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 34640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 34641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 34642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 34643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 34644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 34645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 34646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 34647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 34648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 34649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 34650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 34651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 34652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 34653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 34654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 34655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 34656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 34657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 34658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 34659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 34660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 34661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 34662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 34663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 34664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 34665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 34666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 34667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 34668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 34669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 34670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 34671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 34672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 34673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 34674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 34675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 34676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 34677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 34678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 34679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 34680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 34681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 34682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 34683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 34684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 34685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 34686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 34687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 34688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 34689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 34690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 34691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 34692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 34693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 34694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 34695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 34696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 34697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 34698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 34699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 34700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 34701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 34702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 34703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 34704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 34705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 34706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 34707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 34708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 34709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 34710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 34711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 34712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 34713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 34714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 34715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 34716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 34717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 34718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 34719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 34720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 34721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 34722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 34723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 34724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 34725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 34726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 34727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 34728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 34729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 34730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 34731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 34732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 34733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 34734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 34735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 34736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 34737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 34738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 34739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 34740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 34741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 34742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 34743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 34744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 34745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 34746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 34747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 34748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 34749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 34750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 34751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 34752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 34753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 34754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 34755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 34756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 34757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 34758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 34759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 34760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 34761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 34762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 34763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 34764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 34765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 34766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 34767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 34768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 34769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 34770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 34771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 34772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 34773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 34774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 34775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 34776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 34777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 34778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 34779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 34780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 34781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 34782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 34783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 34784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 34785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 34786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 34787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 34788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 34789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 34790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 34791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 34792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 34793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 34794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 34795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 34796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 34797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 34798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 34799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 34800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 34801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 34802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 34803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 34804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 34805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 34806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 34807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 34808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 34809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 34810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 34811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 34812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 34813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 34814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 34815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 34816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 34817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 34818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 34819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 34820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 34821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 34822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 34823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 34824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 34825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 34826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 34827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 34828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 34829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 34830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 34831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 34832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 34833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 34834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 34835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 34836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 34837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 34838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 34839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 34840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 34841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 34842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 34843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 34844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 34845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 34846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 34847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 34848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 34849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 34850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 34851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 34852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 34853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 34854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 34855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 34856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 34857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 34858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 34859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 34860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 34861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 34862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 34863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 34864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 34865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 34866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 34867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 34868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 34869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 34870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 34871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 34872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 34873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 34874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 34875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 34876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 34877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 34878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 34879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 34880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 34881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 34882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 34883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 34884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 34885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 34886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 34887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 34888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 34889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 34890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 34891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 34892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 34893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 34894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 34895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 34896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 34897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 34898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 34899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 34900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 34901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 34902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 34903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 34904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 34905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 34906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 34907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 34908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 34909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 34910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 34911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 34912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 34913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 34914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 34915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 34916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 34917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 34918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 34919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 34920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 34921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 34922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 34923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 34924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 34925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 34926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 34927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 34928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 34929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 34930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 34931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 34932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 34933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 34934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 34935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 34936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 34937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 34938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 34939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 34940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 34941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 34942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 34943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 34944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 34945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 34946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 34947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 34948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 34949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 34950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSDAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 34951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 34952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 34953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 34954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 34955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 34956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 34957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 34958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 34959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 34960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 34961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 34962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 34963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 34964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 34965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 34966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 34967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 34968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 34969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 34970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 34971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 34972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 34973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 34974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 34975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 34976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 34977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 34978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 34979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 34980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 34981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 34982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 34983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 34984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 34985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 34986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 34987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 34988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 34989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 34990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 34991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 34992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 34993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 34994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 34995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 34996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 34997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 34998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 34999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 35000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 35001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 35002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 35003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 35004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 35005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 35006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 35007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 35008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 35009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 35010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 35011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 35012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 35013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 35014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 35015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 35016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 35017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 35018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 35019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 35020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 35021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 35022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 35023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 35024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 35025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 35026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 35027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 35028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 35029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 35030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 35031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 35032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 35033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 35034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 35035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 35036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 35037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 35038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 35039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 35040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 35041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 35042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 35043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 35044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 35045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 35046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 35047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 35048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 35049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 35050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 35051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 35052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 35053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 35054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 35055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 35056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 35057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 35058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 35059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 35060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 35061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 35062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 35063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 35064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 35065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 35066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 35067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 35068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 35069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 35070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 35071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 35072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 35073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 35074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 35075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 35076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 35077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 35078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 35079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 35080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 35081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 35082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 35083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 35084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 35085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 35086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 35087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 35088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 35089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 35090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 35091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 35092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 35093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 35094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 35095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 35096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 35097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 35098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 35099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 35100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 35101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 35102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 35103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 35104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 35105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 35106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 35107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 35108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 35109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 35110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 35111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 35112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 35113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 35114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 35115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 35116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 35117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 35118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 35119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 35120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 35121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 35122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 35123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 35124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 35125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 35126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 35127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 35128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 35129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 35130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 35131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 35132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 35133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 35134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 35135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 35136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 35137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 35138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 35139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 35140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 35141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 35142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 35143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 35144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 35145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 35146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 35147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 35148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 35149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 35150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 35151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 35152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 35153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 35154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 35155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 35156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 35157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 35158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 35159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 35160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 35161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 35162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 35163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 35164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 35165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 35166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 35167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 35168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 35169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 35170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 35171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 35172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 35173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 35174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 35175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 35176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 35177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 35178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 35179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 35180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 35181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 35182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 35183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 35184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 35185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 35186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 35187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 35188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 35189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 35190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 35191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 35192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 35193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 35194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 35195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 35196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 35197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 35198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 35199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 35200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 35201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 35202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 35203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 35204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 35205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 35206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 35207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 35208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 35209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 35210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 35211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 35212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 35213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 35214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 35215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 35216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 35217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 35218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 35219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 35220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 35221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 35222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 35223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 35224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 35225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 35226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 35227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 35228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 35229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 35230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 35231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 35232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 35233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 35234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 35235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 35236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 35237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 35238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 35239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 35240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 35241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 35242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 35243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 35244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 35245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 35246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 35247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 35248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 35249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 35250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 35251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 35252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 35253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 35254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 35255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 35256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 35257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 35258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 35259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 35260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 35261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 35262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 35263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 35264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 35265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 35266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 35267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 35268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 35269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 35270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 35271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 35272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 35273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 35274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 35275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 35276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 35277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 35278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 35279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 35280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 35281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 35282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 35283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 35284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 35285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 35286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 35287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 35288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 35289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 35290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 35291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 35292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 35293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 35294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 35295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 35296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 35297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 35298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 35299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 35300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 35301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 35302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 35303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 35304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 35305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 35306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 35307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 35308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 35309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 35310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 35311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 35312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 35313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 35314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 35315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 35316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 35317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 35318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 35319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 35320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 35321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 35322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 35323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 35324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 35325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 35326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 35327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 35328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 35329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 35330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 35331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 35332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 35333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 35334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 35335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 35336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 35337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 35338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 35339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 35340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 35341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 35342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 35343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 35344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 35345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 35346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 35347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 35348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 35349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 35350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 35351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 35352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 35353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 35354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 35355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 35356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 35357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 35358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 35359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 35360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 35361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 35362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 35363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 35364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 35365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 35366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 35367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 35368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 35369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 35370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 35371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 35372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 35373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 35374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 35375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 35376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 35377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 35378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 35379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 35380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 35381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 35382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 35383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 35384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 35385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 35386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 35387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 35388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 35389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 35390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 35391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 35392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 35393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 35394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 35395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 35396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 35397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 35398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 35399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 35400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 35401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 35402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 35403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 35404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 35405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 35406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 35407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 35408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 35409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 35410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 35411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 35412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 35413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 35414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 35415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 35416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 35417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 35418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 35419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 35420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 35421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 35422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 35423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 35424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 35425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 35426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 35427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 35428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 35429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 35430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 35431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 35432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 35433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 35434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 35435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 35436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 35437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 35438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 35439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 35440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 35441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 35442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 35443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 35444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 35445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 35446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 35447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 35448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 35449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 35450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 35451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 35452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 35453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 35454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 35455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 35456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 35457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 35458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 35459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 35460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 35461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 35462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 35463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 35464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 35465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 35466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 35467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 35468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 35469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 35470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 35471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 35472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 35473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 35474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 35475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 35476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 35477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 35478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 35479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 35480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 35481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 35482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 35483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 35484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 35485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 35486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 35487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 35488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 35489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 35490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 35491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 35492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 35493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 35494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 35495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 35496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 35497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 35498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 35499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 35500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 35501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 35502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 35503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 35504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 35505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 35506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 35507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 35508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 35509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 35510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 35511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 35512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 35513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 35514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 35515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 35516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 35517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 35518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 35519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 35520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 35521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 35522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 35523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 35524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 35525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 35526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 35527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 35528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 35529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 35530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 35531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 35532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 35533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 35534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 35535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 35536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 35537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 35538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 35539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 35540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 35541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 35542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 35543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 35544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 35545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 35546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 35547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 35548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 35549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 35550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 35551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 35552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 35553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 35554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 35555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 35556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 35557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 35558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 35559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 35560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 35561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 35562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 35563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 35564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 35565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 35566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 35567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 35568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 35569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 35570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 35571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 35572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 35573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 35574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 35575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 35576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 35577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 35578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 35579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 35580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 35581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 35582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 35583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 35584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 35585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 35586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 35587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 35588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 35589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 35590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 35591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 35592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 35593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 35594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 35595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 35596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 35597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 35598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 35599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 35600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 35601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 35602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 35603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 35604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 35605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 35606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 35607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 35608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 35609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 35610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 35611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 35612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 35613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 35614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 35615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 35616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 35617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 35618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 35619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 35620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 35621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 35622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 35623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 35624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 35625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 35626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 35627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 35628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 35629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 35630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 35631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 35632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 35633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 35634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 35635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 35636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 35637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 35638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 35639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 35640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 35641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 35642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 35643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 35644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 35645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 35646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 35647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 35648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 35649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 35650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 35651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 35652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 35653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 35654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 35655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 35656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 35657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 35658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 35659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 35660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 35661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 35662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 35663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 35664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 35665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 35666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 35667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 35668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 35669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 35670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 35671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 35672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 35673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 35674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 35675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 35676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 35677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 35678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 35679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 35680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 35681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 35682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 35683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 35684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 35685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 35686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 35687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 35688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 35689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 35690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 35691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 35692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 35693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 35694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 35695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 35696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 35697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 35698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 35699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 35700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 35701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 35702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 35703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 35704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 35705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 35706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 35707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 35708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 35709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 35710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 35711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 35712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 35713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 35714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 35715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 35716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 35717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 35718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 35719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 35720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 35721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 35722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 35723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 35724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 35725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 35726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 35727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 35728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 35729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 35730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 35731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 35732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 35733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 35734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 35735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 35736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 35737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 35738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 35739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 35740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 35741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 35742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 35743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 35744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 35745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 35746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 35747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 35748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 35749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 35750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 35751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 35752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 35753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 35754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 35755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 35756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 35757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 35758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 35759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 35760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 35761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 35762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 35763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 35764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 35765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 35766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 35767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 35768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 35769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 35770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 35771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 35772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 35773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 35774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 35775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 35776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 35777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 35778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 35779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 35780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 35781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 35782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 35783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 35784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 35785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 35786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 35787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 35788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 35789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 35790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 35791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 35792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 35793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 35794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 35795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 35796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 35797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 35798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 35799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 35800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 35801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 35802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 35803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 35804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 35805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 35806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 35807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 35808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 35809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 35810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 35811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 35812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 35813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 35814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 35815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 35816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 35817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 35818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 35819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 35820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 35821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 35822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 35823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 35824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 35825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 35826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 35827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 35828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 35829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 35830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 35831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 35832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 35833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 35834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 35835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 35836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 35837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 35838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 35839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 35840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 35841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 35842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 35843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 35844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 35845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 35846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 35847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 35848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 35849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 35850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 35851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 35852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 35853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 35854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 35855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 35856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 35857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 35858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 35859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 35860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 35861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 35862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 35863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 35864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 35865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 35866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 35867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 35868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 35869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 35870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 35871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 35872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 35873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 35874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 35875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 35876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 35877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 35878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 35879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 35880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 35881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 35882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 35883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 35884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 35885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 35886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 35887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 35888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 35889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 35890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 35891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 35892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 35893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 35894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 35895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 35896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 35897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 35898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 35899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 35900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 35901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 35902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 35903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 35904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 35905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 35906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 35907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 35908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 35909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 35910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 35911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 35912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 35913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 35914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 35915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 35916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 35917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 35918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 35919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 35920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 35921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 35922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 35923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 35924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 35925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 35926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 35927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 35928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 35929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 35930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 35931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 35932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 35933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 35934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 35935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 35936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 35937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 35938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 35939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 35940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 35941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 35942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 35943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 35944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 35945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 35946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 35947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 35948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 35949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 35950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 35951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 35952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 35953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 35954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 35955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 35956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 35957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 35958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 35959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 35960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 35961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 35962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 35963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 35964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 35965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 35966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 35967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 35968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 35969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 35970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 35971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 35972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 35973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 35974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 35975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 35976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 35977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 35978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 35979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 35980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 35981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 35982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 35983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 35984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 35985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 35986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 35987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 35988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 35989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 35990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 35991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 35992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 35993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 35994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 35995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 35996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 35997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 35998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 35999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 36000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 36001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 36002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 36003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 36004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 36005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 36006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 36007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 36008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 36009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 36010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 36011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 36012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 36013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 36014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 36015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 36016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 36017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 36018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 36019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 36020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 36021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 36022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 36023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 36024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 36025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 36026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 36027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 36028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 36029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 36030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 36031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 36032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 36033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 36034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 36035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 36036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 36037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 36038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 36039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 36040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 36041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 36042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 36043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 36044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 36045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 36046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 36047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 36048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 36049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 36050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 36051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 36052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 36053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 36054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 36055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 36056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 36057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 36058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 36059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 36060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 36061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 36062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 36063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 36064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 36065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 36066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 36067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 36068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 36069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 36070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 36071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 36072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 36073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 36074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 36075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 36076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 36077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 36078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 36079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 36080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 36081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 36082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 36083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 36084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 36085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 36086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 36087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 36088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 36089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 36090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 36091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 36092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 36093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 36094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 36095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 36096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 36097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 36098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 36099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 36100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 36101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 36102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 36103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 36104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 36105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 36106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 36107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 36108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 36109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 36110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 36111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 36112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 36113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 36114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 36115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 36116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 36117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 36118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 36119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 36120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 36121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 36122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 36123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 36124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 36125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 36126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 36127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 36128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 36129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 36130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 36131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 36132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 36133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 36134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 36135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 36136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 36137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 36138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 36139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 36140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 36141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 36142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 36143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 36144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 36145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 36146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 36147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 36148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 36149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 36150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 36151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 36152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 36153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 36154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 36155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 36156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 36157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 36158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 36159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 36160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 36161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 36162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 36163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 36164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 36165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 36166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 36167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 36168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 36169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 36170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 36171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 36172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 36173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 36174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 36175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 36176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 36177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 36178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 36179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 36180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 36181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 36182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 36183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 36184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 36185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 36186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 36187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 36188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 36189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 36190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 36191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 36192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 36193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 36194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 36195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 36196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 36197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 36198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 36199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 36200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 36201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 36202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 36203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 36204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 36205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 36206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 36207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 36208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 36209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 36210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 36211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 36212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 36213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 36214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 36215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 36216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 36217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 36218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 36219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 36220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 36221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 36222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 36223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 36224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 36225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 36226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 36227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 36228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 36229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 36230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 36231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 36232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 36233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 36234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 36235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 36236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 36237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 36238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 36239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 36240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 36241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 36242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 36243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 36244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 36245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 36246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 36247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 36248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 36249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 36250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 36251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 36252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 36253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 36254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 36255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 36256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 36257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 36258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 36259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 36260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 36261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 36262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 36263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 36264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 36265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 36266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 36267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 36268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 36269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 36270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 36271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 36272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 36273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 36274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 36275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 36276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 36277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 36278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 36279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 36280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 36281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 36282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 36283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 36284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 36285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 36286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 36287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 36288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 36289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 36290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 36291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 36292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 36293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 36294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 36295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 36296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 36297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 36298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 36299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 36300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 36301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 36302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 36303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 36304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 36305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 36306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 36307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 36308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 36309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 36310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 36311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 36312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 36313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 36314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 36315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 36316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 36317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 36318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 36319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 36320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 36321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 36322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 36323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 36324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 36325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 36326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 36327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 36328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 36329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 36330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 36331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 36332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 36333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 36334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 36335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 36336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 36337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 36338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 36339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 36340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 36341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 36342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 36343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 36344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 36345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 36346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 36347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 36348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 36349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 36350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 36351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 36352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 36353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 36354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 36355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 36356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 36357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 36358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 36359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 36360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 36361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 36362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 36363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 36364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 36365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 36366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 36367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 36368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 36369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 36370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 36371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 36372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 36373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 36374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 36375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 36376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 36377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 36378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 36379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 36380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 36381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 36382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 36383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 36384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 36385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 36386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 36387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 36388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 36389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 36390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 36391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 36392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 36393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 36394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 36395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 36396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 36397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 36398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 36399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 36400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 36401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 36402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 36403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 36404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 36405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 36406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 36407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 36408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 36409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 36410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 36411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 36412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 36413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 36414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 36415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 36416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 36417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 36418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 36419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 36420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 36421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 36422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 36423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 36424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 36425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 36426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 36427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 36428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 36429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 36430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 36431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 36432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 36433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 36434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 36435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 36436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 36437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 36438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 36439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 36440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 36441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 36442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 36443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 36444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 36445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 36446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 36447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 36448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 36449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 36450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 36451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 36452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 36453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 36454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 36455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 36456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 36457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 36458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 36459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 36460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 36461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 36462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 36463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 36464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 36465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 36466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 36467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 36468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 36469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 36470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 36471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 36472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 36473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 36474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 36475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 36476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 36477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 36478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 36479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 36480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 36481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 36482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 36483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 36484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 36485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 36486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 36487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 36488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 36489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 36490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 36491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 36492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 36493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 36494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 36495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 36496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 36497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 36498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 36499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 36500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 36501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 36502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 36503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 36504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 36505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 36506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 36507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 36508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 36509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 36510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 36511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 36512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 36513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 36514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 36515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 36516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 36517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 36518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 36519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 36520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 36521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 36522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 36523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 36524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 36525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 36526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 36527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 36528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 36529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 36530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 36531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 36532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 36533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 36534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 36535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 36536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 36537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 36538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 36539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 36540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 36541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 36542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 36543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 36544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 36545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 36546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 36547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 36548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 36549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 36550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 36551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 36552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 36553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 36554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 36555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 36556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 36557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 36558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 36559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 36560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 36561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 36562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 36563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 36564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 36565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 36566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 36567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 36568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 36569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 36570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 36571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 36572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 36573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 36574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 36575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 36576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 36577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 36578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 36579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 36580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 36581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 36582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 36583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 36584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 36585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 36586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 36587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 36588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 36589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 36590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 36591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 36592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 36593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 36594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 36595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 36596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 36597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 36598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 36599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 36600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 36601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 36602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 36603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 36604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 36605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 36606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 36607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 36608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 36609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 36610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 36611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 36612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 36613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 36614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 36615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 36616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 36617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 36618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 36619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 36620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 36621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 36622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 36623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 36624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 36625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 36626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 36627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 36628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 36629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 36630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 36631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 36632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 36633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 36634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 36635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 36636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 36637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 36638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 36639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 36640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 36641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 36642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 36643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 36644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 36645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 36646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 36647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 36648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 36649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 36650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 36651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 36652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 36653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 36654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 36655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 36656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 36657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 36658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 36659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 36660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 36661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 36662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 36663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 36664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 36665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 36666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 36667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 36668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 36669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 36670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 36671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 36672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 36673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 36674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 36675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 36676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 36677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 36678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 36679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 36680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 36681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 36682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 36683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 36684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 36685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 36686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 36687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 36688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 36689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 36690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 36691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 36692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 36693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 36694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 36695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 36696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 36697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 36698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 36699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 36700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 36701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 36702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 36703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 36704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 36705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 36706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 36707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 36708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 36709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 36710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 36711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 36712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 36713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 36714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 36715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 36716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 36717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 36718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 36719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 36720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 36721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 36722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 36723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 36724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 36725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 36726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 36727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 36728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 36729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 36730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 36731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 36732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 36733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 36734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 36735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 36736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 36737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 36738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 36739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 36740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 36741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 36742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 36743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 36744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 36745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 36746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 36747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 36748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 36749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 36750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 36751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 36752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 36753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 36754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 36755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 36756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 36757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 36758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 36759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 36760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 36761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 36762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 36763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 36764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 36765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 36766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 36767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 36768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 36769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 36770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 36771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 36772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 36773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 36774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 36775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 36776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 36777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 36778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 36779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 36780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 36781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 36782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 36783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 36784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 36785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 36786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 36787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 36788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 36789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 36790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 36791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 36792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 36793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 36794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 36795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 36796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 36797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 36798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 36799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 36800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 36801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 36802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 36803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 36804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 36805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 36806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 36807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 36808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 36809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 36810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 36811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 36812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 36813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 36814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 36815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 36816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 36817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 36818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 36819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 36820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 36821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 36822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 36823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 36824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 36825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 36826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 36827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 36828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 36829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 36830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 36831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 36832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 36833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 36834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 36835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 36836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 36837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 36838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 36839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 36840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 36841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 36842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 36843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 36844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 36845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 36846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 36847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 36848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 36849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 36850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 36851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 36852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 36853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 36854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 36855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 36856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 36857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 36858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 36859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 36860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 36861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 36862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 36863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 36864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 36865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 36866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 36867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 36868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 36869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 36870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 36871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 36872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 36873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 36874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 36875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 36876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 36877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 36878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 36879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 36880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 36881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 36882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 36883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 36884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 36885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 36886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 36887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 36888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 36889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 36890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 36891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 36892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 36893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 36894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 36895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 36896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 36897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 36898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 36899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 36900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 36901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 36902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 36903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 36904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 36905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 36906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 36907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 36908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 36909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 36910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 36911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 36912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 36913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 36914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 36915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 36916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 36917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 36918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 36919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 36920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 36921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 36922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 36923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 36924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 36925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 36926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 36927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 36928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 36929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 36930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 36931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 36932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 36933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 36934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 36935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 36936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 36937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 36938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 36939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 36940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 36941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 36942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 36943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 36944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 36945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 36946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 36947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 36948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 36949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 36950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 36951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 36952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 36953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 36954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 36955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 36956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 36957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 36958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 36959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 36960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 36961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 36962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 36963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 36964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 36965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 36966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 36967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 36968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 36969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 36970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 36971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 36972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 36973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 36974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 36975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 36976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 36977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 36978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 36979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 36980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 36981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 36982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 36983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 36984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 36985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 36986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 36987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 36988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 36989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 36990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 36991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 36992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 36993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 36994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 36995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 36996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 36997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 36998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAEFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 36999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 37000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 37001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 37002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 37003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 37004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 37005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 37006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 37007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 37008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 37009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 37010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 37011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 37012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 37013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 37014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 37015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 37016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 37017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 37018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 37019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 37020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 37021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 37022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 37023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 37024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 37025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 37026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 37027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 37028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 37029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 37030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 37031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 37032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 37033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 37034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 37035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 37036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 37037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 37038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 37039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 37040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 37041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 37042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 37043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 37044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 37045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 37046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 37047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 37048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 37049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 37050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 37051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 37052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 37053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 37054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 37055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 37056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 37057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 37058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 37059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 37060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 37061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 37062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 37063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 37064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 37065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 37066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 37067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 37068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 37069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 37070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 37071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 37072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 37073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 37074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 37075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 37076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 37077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 37078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 37079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 37080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 37081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 37082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 37083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 37084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 37085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 37086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 37087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 37088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 37089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 37090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 37091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 37092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 37093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 37094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 37095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 37096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 37097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 37098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 37099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 37100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 37101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 37102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 37103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 37104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 37105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 37106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 37107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 37108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 37109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 37110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 37111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 37112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 37113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 37114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 37115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 37116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 37117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 37118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 37119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 37120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 37121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 37122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 37123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 37124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 37125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 37126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 37127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 37128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 37129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 37130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 37131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 37132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 37133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 37134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 37135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 37136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 37137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 37138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 37139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 37140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 37141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 37142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 37143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 37144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 37145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 37146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 37147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 37148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 37149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 37150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 37151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 37152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 37153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 37154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 37155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 37156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 37157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 37158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 37159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 37160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 37161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 37162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 37163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 37164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 37165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 37166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 37167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 37168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 37169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 37170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 37171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 37172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 37173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 37174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 37175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 37176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 37177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 37178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 37179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 37180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 37181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 37182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 37183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 37184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 37185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 37186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 37187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 37188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 37189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 37190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 37191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 37192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 37193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 37194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 37195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 37196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 37197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 37198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 37199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 37200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 37201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 37202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 37203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 37204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 37205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 37206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 37207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 37208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 37209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 37210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 37211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 37212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 37213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 37214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 37215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 37216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 37217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 37218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 37219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 37220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 37221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 37222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 37223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 37224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 37225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 37226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 37227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 37228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 37229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 37230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 37231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 37232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 37233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 37234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 37235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 37236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 37237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 37238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 37239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 37240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 37241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 37242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 37243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 37244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 37245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 37246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 37247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 37248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 37249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 37250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 37251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 37252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 37253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 37254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 37255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 37256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 37257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 37258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 37259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 37260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 37261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 37262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 37263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 37264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 37265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 37266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 37267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 37268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 37269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 37270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 37271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 37272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 37273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 37274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 37275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 37276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 37277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 37278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 37279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 37280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 37281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 37282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 37283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 37284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 37285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 37286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 37287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 37288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 37289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 37290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 37291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 37292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 37293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 37294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 37295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 37296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 37297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 37298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 37299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 37300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 37301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 37302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 37303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 37304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 37305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 37306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 37307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 37308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 37309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 37310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 37311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 37312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 37313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 37314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 37315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 37316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 37317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 37318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 37319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 37320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 37321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 37322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 37323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 37324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 37325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 37326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 37327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 37328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 37329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 37330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 37331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 37332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 37333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 37334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 37335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 37336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 37337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 37338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 37339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 37340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 37341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 37342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 37343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 37344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 37345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 37346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 37347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 37348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 37349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 37350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 37351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 37352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 37353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 37354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 37355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 37356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 37357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 37358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 37359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 37360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 37361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 37362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 37363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 37364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 37365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 37366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 37367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 37368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 37369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 37370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 37371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 37372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 37373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 37374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 37375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 37376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 37377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 37378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 37379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 37380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 37381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 37382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 37383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 37384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 37385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 37386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 37387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 37388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 37389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 37390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 37391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 37392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 37393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 37394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 37395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 37396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 37397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 37398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 37399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 37400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 37401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 37402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 37403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 37404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 37405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 37406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 37407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 37408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 37409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 37410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 37411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 37412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 37413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 37414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 37415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 37416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 37417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 37418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 37419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 37420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 37421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 37422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 37423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 37424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 37425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 37426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 37427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 37428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 37429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 37430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 37431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 37432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 37433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 37434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 37435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 37436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 37437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 37438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 37439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 37440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 37441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 37442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 37443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 37444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 37445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 37446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 37447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 37448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 37449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 37450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 37451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 37452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 37453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 37454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 37455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 37456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 37457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 37458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 37459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 37460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 37461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 37462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 37463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 37464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 37465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 37466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 37467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 37468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 37469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 37470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 37471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 37472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 37473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 37474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 37475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 37476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 37477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 37478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 37479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 37480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 37481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 37482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 37483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 37484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 37485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 37486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 37487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 37488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 37489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 37490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 37491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 37492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 37493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 37494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 37495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 37496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 37497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 37498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 37499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 37500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 37501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 37502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 37503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 37504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 37505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 37506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 37507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 37508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 37509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 37510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 37511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 37512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 37513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 37514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 37515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 37516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 37517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 37518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 37519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 37520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 37521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 37522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 37523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 37524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 37525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 37526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 37527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 37528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 37529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 37530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 37531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 37532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 37533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 37534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 37535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 37536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 37537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 37538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 37539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 37540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 37541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 37542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 37543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 37544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 37545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 37546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 37547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 37548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 37549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 37550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 37551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 37552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 37553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 37554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 37555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 37556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 37557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 37558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 37559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 37560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 37561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 37562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 37563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 37564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 37565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 37566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 37567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 37568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 37569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 37570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 37571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 37572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 37573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 37574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 37575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 37576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 37577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 37578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 37579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 37580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 37581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 37582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 37583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 37584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 37585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 37586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 37587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 37588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 37589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 37590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 37591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 37592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 37593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 37594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 37595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 37596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 37597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 37598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 37599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 37600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 37601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 37602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 37603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 37604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 37605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 37606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 37607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 37608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 37609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 37610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 37611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 37612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 37613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 37614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 37615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 37616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 37617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 37618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 37619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 37620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 37621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 37622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 37623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 37624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 37625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 37626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 37627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 37628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 37629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 37630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 37631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 37632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 37633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 37634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 37635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 37636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 37637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 37638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 37639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 37640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 37641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 37642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 37643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 37644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 37645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 37646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 37647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 37648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 37649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 37650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 37651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 37652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 37653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 37654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 37655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 37656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 37657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 37658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 37659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 37660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 37661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 37662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 37663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 37664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 37665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 37666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 37667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 37668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 37669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 37670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 37671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 37672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 37673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 37674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 37675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 37676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 37677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 37678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 37679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 37680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 37681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 37682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 37683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 37684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 37685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 37686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 37687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 37688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 37689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 37690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 37691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 37692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 37693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 37694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 37695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 37696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 37697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 37698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 37699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 37700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 37701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 37702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 37703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 37704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 37705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 37706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 37707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 37708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 37709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 37710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 37711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 37712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 37713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 37714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 37715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 37716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 37717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 37718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 37719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 37720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 37721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 37722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 37723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 37724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 37725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 37726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 37727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 37728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 37729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 37730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 37731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 37732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 37733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 37734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 37735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 37736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 37737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 37738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 37739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 37740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 37741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 37742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 37743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 37744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 37745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 37746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 37747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 37748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 37749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 37750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 37751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 37752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 37753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 37754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 37755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 37756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 37757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 37758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 37759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 37760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 37761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 37762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 37763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 37764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 37765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 37766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 37767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 37768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 37769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 37770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 37771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 37772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 37773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 37774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 37775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 37776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 37777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 37778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 37779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 37780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 37781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 37782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 37783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 37784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 37785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 37786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 37787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 37788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 37789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 37790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 37791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 37792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 37793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 37794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 37795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 37796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 37797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 37798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 37799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 37800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 37801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 37802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 37803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 37804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 37805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 37806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 37807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 37808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 37809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 37810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 37811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 37812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 37813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 37814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 37815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 37816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 37817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 37818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 37819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 37820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 37821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 37822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 37823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 37824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 37825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 37826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 37827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 37828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 37829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 37830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 37831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 37832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 37833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 37834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 37835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 37836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 37837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 37838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 37839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 37840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 37841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 37842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 37843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 37844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 37845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 37846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 37847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 37848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 37849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 37850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 37851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 37852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 37853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 37854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 37855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 37856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 37857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 37858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 37859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 37860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 37861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 37862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 37863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 37864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 37865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 37866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 37867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 37868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 37869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 37870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 37871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 37872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 37873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 37874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 37875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 37876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 37877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 37878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 37879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 37880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 37881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 37882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 37883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 37884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 37885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 37886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 37887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 37888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 37889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 37890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 37891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 37892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 37893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 37894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 37895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 37896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 37897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 37898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 37899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 37900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 37901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 37902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 37903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 37904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 37905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 37906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 37907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 37908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 37909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 37910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 37911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 37912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 37913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 37914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 37915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 37916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 37917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 37918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 37919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 37920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 37921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 37922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 37923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 37924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 37925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 37926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 37927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 37928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 37929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 37930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 37931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 37932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 37933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 37934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 37935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 37936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 37937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 37938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 37939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 37940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 37941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 37942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 37943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 37944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 37945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 37946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 37947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 37948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 37949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 37950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 37951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 37952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 37953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 37954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 37955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 37956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 37957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 37958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 37959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 37960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 37961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 37962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 37963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 37964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 37965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 37966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 37967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 37968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 37969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 37970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 37971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 37972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 37973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 37974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 37975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 37976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 37977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 37978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 37979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 37980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 37981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 37982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 37983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 37984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 37985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 37986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 37987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 37988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 37989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 37990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 37991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 37992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 37993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 37994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 37995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 37996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 37997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 37998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 37999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 38000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 38001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 38002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 38003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 38004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 38005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 38006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 38007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 38008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 38009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 38010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 38011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 38012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 38013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 38014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 38015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 38016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 38017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 38018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 38019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 38020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 38021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 38022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 38023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 38024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 38025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 38026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 38027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 38028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 38029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 38030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 38031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 38032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 38033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 38034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 38035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 38036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 38037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 38038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 38039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 38040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 38041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 38042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 38043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 38044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 38045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 38046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 38047 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 38048 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 38049 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 38050 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 38051 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 38052 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 38053 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 38054 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 38055 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 38056 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 38057 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 38058 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 38059 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 38060 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 38061 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 38062 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 38063 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 38064 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 38065 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 38066 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 38067 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 38068 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 38069 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 38070 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 38071 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 38072 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 38073 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 38074 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 38075 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 38076 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 38077 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 38078 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 38079 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 38080 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 38081 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 38082 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 38083 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 38084 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 38085 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 38086 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 38087 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 38088 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 38089 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 38090 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 38091 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 38092 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 38093 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 38094 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 38095 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 38096 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 38097 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 38098 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 38099 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 38100 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 38101 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 38102 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 38103 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 38104 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 38105 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 38106 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 38107 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 38108 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 38109 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 38110 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 38111 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 38112 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 38113 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 38114 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 38115 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 38116 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 38117 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 38118 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 38119 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 38120 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 38121 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 38122 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 38123 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 38124 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 38125 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 38126 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 38127 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 38128 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 38129 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 38130 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 38131 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 38132 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 38133 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 38134 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 38135 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 38136 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 38137 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 38138 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 38139 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 38140 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 38141 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 38142 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 38143 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 38144 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 38145 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 38146 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 38147 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 38148 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 38149 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 38150 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 38151 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 38152 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 38153 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 38154 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 38155 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 38156 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 38157 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 38158 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 38159 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 38160 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 38161 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 38162 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 38163 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 38164 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 38165 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 38166 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 38167 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 38168 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 38169 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 38170 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 38171 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 38172 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 38173 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 38174 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 38175 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 38176 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 38177 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 38178 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 38179 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 38180 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 38181 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 38182 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 38183 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 38184 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 38185 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 38186 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 38187 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 38188 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 38189 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 38190 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 38191 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 38192 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 38193 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 38194 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 38195 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 38196 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 38197 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 38198 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 38199 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 38200 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 38201 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 38202 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 38203 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 38204 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 38205 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 38206 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 38207 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 38208 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 38209 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 38210 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 38211 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 38212 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 38213 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 38214 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 38215 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 38216 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 38217 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 38218 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 38219 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 38220 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 38221 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 38222 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 38223 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 38224 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 38225 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 38226 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 38227 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 38228 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 38229 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 38230 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 38231 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 38232 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 38233 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 38234 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 38235 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 38236 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 38237 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 38238 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 38239 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 38240 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 38241 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 38242 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 38243 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 38244 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 38245 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 38246 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 38247 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 38248 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 38249 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 38250 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 38251 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 38252 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 38253 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 38254 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 38255 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 38256 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 38257 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 38258 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 38259 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 38260 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 38261 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 38262 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 38263 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 38264 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 38265 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 38266 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 38267 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 38268 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 38269 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 38270 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 38271 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 38272 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 38273 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 38274 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 38275 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 38276 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 38277 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 38278 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 38279 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 38280 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 38281 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 38282 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 38283 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 38284 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 38285 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 38286 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 38287 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 38288 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 38289 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 38290 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 38291 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 38292 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 38293 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 38294 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 38295 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 38296 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 38297 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 38298 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 38299 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 38300 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 38301 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 38302 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 38303 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 38304 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 38305 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 38306 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 38307 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 38308 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 38309 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 38310 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 38311 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 38312 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 38313 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 38314 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 38315 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 38316 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 38317 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 38318 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 38319 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 38320 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 38321 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 38322 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 38323 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 38324 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 38325 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 38326 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 38327 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 38328 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 38329 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 38330 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 38331 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 38332 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 38333 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 38334 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 38335 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 38336 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 38337 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 38338 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 38339 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 38340 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 38341 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 38342 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 38343 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 38344 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 38345 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 38346 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 38347 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 38348 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 38349 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 38350 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 38351 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 38352 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 38353 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 38354 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 38355 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 38356 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 38357 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 38358 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 38359 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 38360 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 38361 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 38362 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 38363 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 38364 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 38365 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 38366 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 38367 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 38368 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 38369 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 38370 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 38371 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 38372 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 38373 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 38374 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 38375 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 38376 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 38377 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 38378 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 38379 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 38380 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 38381 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 38382 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 38383 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 38384 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 38385 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 38386 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 38387 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 38388 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 38389 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 38390 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 38391 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 38392 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 38393 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 38394 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 38395 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 38396 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 38397 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 38398 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 38399 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 38400 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 38401 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 38402 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 38403 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 38404 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 38405 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 38406 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 38407 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 38408 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 38409 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 38410 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 38411 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 38412 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 38413 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 38414 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 38415 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 38416 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 38417 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 38418 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 38419 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 38420 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 38421 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 38422 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 38423 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 38424 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 38425 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 38426 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 38427 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 38428 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 38429 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 38430 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 38431 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 38432 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 38433 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 38434 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 38435 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 38436 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 38437 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 38438 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 38439 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 38440 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 38441 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 38442 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 38443 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 38444 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 38445 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 38446 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 38447 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 38448 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 38449 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 38450 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 38451 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 38452 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 38453 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 38454 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 38455 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 38456 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 38457 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 38458 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 38459 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 38460 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 38461 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 38462 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 38463 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 38464 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 38465 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 38466 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 38467 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 38468 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 38469 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 38470 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 38471 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 38472 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 38473 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 38474 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 38475 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 38476 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 38477 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 38478 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 38479 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 38480 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 38481 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 38482 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 38483 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 38484 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 38485 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 38486 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 38487 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 38488 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 38489 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 38490 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 38491 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 38492 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 38493 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 38494 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 38495 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 38496 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 38497 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 38498 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 38499 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 38500 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 38501 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 38502 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 38503 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 38504 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 38505 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 38506 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 38507 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 38508 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 38509 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 38510 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 38511 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 38512 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 38513 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 38514 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 38515 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 38516 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 38517 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 38518 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 38519 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 38520 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 38521 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 38522 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 38523 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 38524 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 38525 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 38526 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 38527 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 38528 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 38529 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 38530 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 38531 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 38532 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 38533 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 38534 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 38535 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 38536 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 38537 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 38538 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 38539 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 38540 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 38541 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 38542 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 38543 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 38544 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 38545 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 38546 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 38547 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 38548 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 38549 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 38550 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 38551 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 38552 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 38553 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 38554 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 38555 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 38556 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 38557 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 38558 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 38559 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 38560 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 38561 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 38562 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 38563 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 38564 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 38565 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 38566 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 38567 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 38568 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 38569 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 38570 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 38571 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 38572 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 38573 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 38574 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 38575 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 38576 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 38577 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 38578 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 38579 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 38580 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 38581 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 38582 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 38583 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 38584 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 38585 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 38586 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 38587 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 38588 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 38589 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 38590 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 38591 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 38592 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 38593 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 38594 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 38595 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 38596 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 38597 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 38598 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 38599 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 38600 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 38601 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 38602 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 38603 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 38604 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 38605 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 38606 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 38607 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 38608 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 38609 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 38610 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 38611 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 38612 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 38613 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 38614 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 38615 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 38616 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 38617 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 38618 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 38619 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 38620 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 38621 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 38622 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 38623 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 38624 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 38625 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 38626 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 38627 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 38628 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 38629 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 38630 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 38631 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 38632 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 38633 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 38634 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 38635 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 38636 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 38637 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 38638 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 38639 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 38640 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 38641 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 38642 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 38643 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 38644 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 38645 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 38646 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 38647 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 38648 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 38649 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 38650 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 38651 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 38652 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 38653 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 38654 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 38655 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 38656 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 38657 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 38658 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 38659 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 38660 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 38661 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 38662 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 38663 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 38664 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 38665 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 38666 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 38667 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 38668 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 38669 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 38670 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 38671 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 38672 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 38673 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 38674 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 38675 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 38676 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 38677 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 38678 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 38679 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 38680 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 38681 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 38682 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 38683 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 38684 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 38685 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 38686 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 38687 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 38688 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 38689 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 38690 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 38691 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 38692 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 38693 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 38694 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 38695 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 38696 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 38697 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 38698 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 38699 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 38700 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 38701 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 38702 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 38703 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 38704 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 38705 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 38706 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 38707 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 38708 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 38709 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 38710 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 38711 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 38712 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 38713 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 38714 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 38715 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 38716 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 38717 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 38718 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 38719 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 38720 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 38721 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 38722 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 38723 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 38724 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 38725 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 38726 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 38727 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 38728 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 38729 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 38730 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 38731 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 38732 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 38733 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 38734 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 38735 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 38736 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 38737 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 38738 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 38739 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 38740 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 38741 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 38742 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 38743 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 38744 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 38745 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 38746 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 38747 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 38748 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 38749 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 38750 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 38751 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 38752 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 38753 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 38754 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 38755 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 38756 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 38757 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 38758 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 38759 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 38760 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 38761 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 38762 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 38763 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 38764 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 38765 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 38766 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 38767 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 38768 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 38769 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 38770 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 38771 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 38772 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 38773 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 38774 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 38775 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 38776 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 38777 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 38778 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 38779 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 38780 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 38781 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 38782 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 38783 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 38784 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 38785 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 38786 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 38787 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 38788 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 38789 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 38790 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 38791 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 38792 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 38793 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 38794 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 38795 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 38796 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 38797 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 38798 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 38799 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 38800 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 38801 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 38802 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 38803 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 38804 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 38805 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 38806 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 38807 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 38808 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 38809 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 38810 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 38811 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 38812 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 38813 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 38814 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 38815 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 38816 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 38817 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 38818 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 38819 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 38820 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 38821 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 38822 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 38823 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 38824 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 38825 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 38826 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 38827 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 38828 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 38829 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 38830 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 38831 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 38832 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 38833 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 38834 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 38835 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 38836 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 38837 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 38838 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 38839 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 38840 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 38841 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 38842 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 38843 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 38844 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 38845 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 38846 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 38847 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 38848 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 38849 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 38850 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 38851 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 38852 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 38853 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 38854 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 38855 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 38856 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 38857 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 38858 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 38859 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 38860 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 38861 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 38862 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 38863 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 38864 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 38865 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 38866 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 38867 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 38868 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 38869 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 38870 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 38871 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 38872 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 38873 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 38874 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 38875 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 38876 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 38877 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 38878 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 38879 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 38880 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 38881 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 38882 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 38883 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 38884 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 38885 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 38886 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 38887 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 38888 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 38889 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 38890 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 38891 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 38892 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 38893 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 38894 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 38895 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 38896 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 38897 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 38898 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 38899 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 38900 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 38901 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 38902 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 38903 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 38904 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 38905 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 38906 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 38907 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 38908 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 38909 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 38910 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 38911 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 38912 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 38913 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 38914 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 38915 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 38916 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 38917 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 38918 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 38919 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 38920 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 38921 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 38922 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 38923 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 38924 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 38925 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 38926 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 38927 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 38928 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 38929 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 38930 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 38931 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 38932 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 38933 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 38934 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 38935 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 38936 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 38937 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 38938 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 38939 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 38940 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 38941 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 38942 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 38943 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 38944 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 38945 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 38946 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 38947 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 38948 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 38949 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 38950 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 38951 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 38952 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 38953 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 38954 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 38955 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 38956 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 38957 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 38958 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 38959 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 38960 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 38961 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 38962 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 38963 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 38964 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 38965 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 38966 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 38967 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 38968 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 38969 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 38970 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 38971 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 38972 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 38973 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 38974 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 38975 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 38976 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 38977 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 38978 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 38979 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 38980 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 38981 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 38982 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 38983 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 38984 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 38985 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 38986 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 38987 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 38988 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 38989 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 38990 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 38991 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 38992 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 38993 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 38994 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 38995 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 38996 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 38997 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 38998 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 38999 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 39000 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 39001 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 39002 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 39003 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 39004 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 39005 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 39006 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 39007 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 39008 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 39009 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 39010 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 39011 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 39012 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 39013 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 39014 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 39015 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 39016 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 39017 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 39018 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 39019 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 39020 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 39021 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 39022 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 39023 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 39024 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 39025 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 39026 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 39027 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 39028 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 39029 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 39030 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 39031 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 39032 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 39033 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 39034 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 39035 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 39036 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 39037 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 39038 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 39039 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 39040 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 39041 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 39042 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 39043 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 39044 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 39045 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 39046 - protein, 189 aa, Artificial Sequence
  Artificially synthesized modified ADAM10 peptide
NPLNKYIRHYEGLSYNVDSLHQKHQRAKAAVSHEAAFLRLDFHAHGRHFNLRMKADTSLFSAAFKVETSNKVLDYDTSHIYTGHIYGAAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 39047 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 39048 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 39049 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 39050 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 39051 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 39052 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 39053 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 39054 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 39055 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 39056 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 39057 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 39058 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 39059 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 39060 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 39061 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 39062 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 39063 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 39064 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 39065 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 39066 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 39067 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 39068 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 39069 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 39070 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 39071 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 39072 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 39073 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 39074 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 39075 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 39076 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 39077 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 39078 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 39079 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 39080 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 39081 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 39082 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 39083 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 39084 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 39085 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 39086 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 39087 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 39088 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 39089 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 39090 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 39091 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 39092 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 39093 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 39094 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 39095 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 39096 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 39097 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 39098 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 39099 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 39100 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 39101 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 39102 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 39103 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 39104 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 39105 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 39106 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 39107 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 39108 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 39109 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 39110 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 39111 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 39112 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 39113 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 39114 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 39115 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 39116 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 39117 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 39118 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 39119 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 39120 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 39121 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 39122 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 39123 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 39124 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 39125 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 39126 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 39127 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 39128 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 39129 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 39130 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 39131 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 39132 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 39133 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 39134 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 39135 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 39136 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 39137 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 39138 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 39139 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 39140 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 39141 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 39142 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 39143 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 39144 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 39145 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 39146 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 39147 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 39148 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 39149 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 39150 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 39151 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 39152 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 39153 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 39154 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 39155 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 39156 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 39157 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 39158 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 39159 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 39160 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 39161 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 39162 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 39163 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 39164 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 39165 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 39166 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 39167 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 39168 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 39169 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 39170 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 39171 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 39172 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 39173 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 39174 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 39175 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 39176 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 39177 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 39178 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 39179 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 39180 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 39181 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 39182 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 39183 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 39184 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 39185 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 39186 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 39187 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 39188 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 39189 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 39190 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 39191 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 39192 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 39193 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 39194 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 39195 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 39196 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 39197 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 39198 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 39199 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 39200 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 39201 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 39202 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 39203 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 39204 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 39205 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 39206 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 39207 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 39208 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 39209 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 39210 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 39211 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 39212 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 39213 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 39214 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 39215 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 39216 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 39217 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 39218 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 39219 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 39220 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 39221 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 39222 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 39223 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 39224 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 39225 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 39226 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 39227 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 39228 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 39229 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 39230 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 39231 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 39232 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 39233 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 39234 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 39235 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 39236 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 39237 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 39238 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 39239 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 39240 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 39241 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 39242 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 39243 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 39244 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 39245 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 39246 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 39247 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 39248 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 39249 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 39250 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 39251 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 39252 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 39253 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 39254 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 39255 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 39256 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 39257 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 39258 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 39259 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 39260 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 39261 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 39262 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 39263 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 39264 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 39265 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 39266 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 39267 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 39268 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 39269 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 39270 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 39271 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 39272 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 39273 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 39274 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 39275 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 39276 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 39277 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 39278 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 39279 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 39280 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 39281 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 39282 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 39283 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 39284 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 39285 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 39286 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 39287 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 39288 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 39289 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 39290 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 39291 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 39292 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 39293 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 39294 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 39295 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 39296 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 39297 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 39298 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 39299 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 39300 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 39301 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 39302 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 39303 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 39304 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 39305 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 39306 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 39307 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 39308 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 39309 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 39310 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 39311 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 39312 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 39313 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 39314 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 39315 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 39316 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 39317 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 39318 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 39319 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 39320 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 39321 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 39322 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 39323 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 39324 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 39325 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 39326 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 39327 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 39328 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 39329 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 39330 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 39331 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 39332 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 39333 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 39334 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 39335 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 39336 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 39337 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 39338 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 39339 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 39340 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 39341 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 39342 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 39343 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 39344 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 39345 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 39346 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 39347 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 39348 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 39349 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 39350 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 39351 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 39352 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 39353 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 39354 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 39355 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 39356 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 39357 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 39358 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 39359 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 39360 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 39361 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 39362 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 39363 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 39364 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 39365 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 39366 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 39367 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 39368 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 39369 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 39370 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 39371 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 39372 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 39373 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 39374 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 39375 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 39376 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 39377 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 39378 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 39379 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 39380 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 39381 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 39382 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 39383 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 39384 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 39385 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 39386 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 39387 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 39388 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 39389 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 39390 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 39391 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 39392 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 39393 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 39394 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 39395 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 39396 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 39397 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 39398 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 39399 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 39400 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 39401 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 39402 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 39403 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 39404 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 39405 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 39406 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 39407 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 39408 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 39409 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 39410 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 39411 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 39412 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 39413 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 39414 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 39415 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 39416 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 39417 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 39418 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 39419 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 39420 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 39421 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 39422 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 39423 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 39424 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 39425 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 39426 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 39427 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 39428 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 39429 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 39430 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 39431 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 39432 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 39433 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 39434 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 39435 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 39436 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 39437 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 39438 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 39439 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 39440 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 39441 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 39442 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 39443 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 39444 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 39445 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 39446 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 39447 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 39448 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 39449 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 39450 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 39451 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 39452 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 39453 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 39454 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 39455 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 39456 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 39457 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 39458 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 39459 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 39460 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 39461 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 39462 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 39463 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 39464 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 39465 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 39466 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 39467 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 39468 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 39469 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 39470 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 39471 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 39472 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 39473 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 39474 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 39475 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 39476 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 39477 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 39478 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 39479 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 39480 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 39481 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 39482 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 39483 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 39484 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 39485 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 39486 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 39487 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 39488 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 39489 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 39490 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 39491 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 39492 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 39493 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 39494 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 39495 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 39496 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 39497 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 39498 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 39499 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 39500 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 39501 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 39502 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 39503 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 39504 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 39505 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 39506 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 39507 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 39508 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 39509 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 39510 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 39511 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 39512 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 39513 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 39514 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 39515 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 39516 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 39517 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 39518 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 39519 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 39520 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 39521 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 39522 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 39523 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 39524 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 39525 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 39526 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 39527 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 39528 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 39529 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 39530 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 39531 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 39532 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 39533 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 39534 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 39535 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 39536 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 39537 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 39538 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 39539 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 39540 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 39541 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 39542 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 39543 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 39544 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 39545 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 39546 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 39547 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 39548 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 39549 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 39550 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 39551 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 39552 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 39553 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 39554 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 39555 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 39556 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 39557 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 39558 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 39559 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 39560 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 39561 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 39562 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 39563 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 39564 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 39565 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 39566 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 39567 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 39568 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 39569 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 39570 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 39571 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 39572 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 39573 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 39574 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 39575 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 39576 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 39577 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 39578 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 39579 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 39580 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 39581 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 39582 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 39583 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 39584 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 39585 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 39586 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 39587 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 39588 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 39589 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 39590 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 39591 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 39592 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 39593 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 39594 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 39595 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 39596 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 39597 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 39598 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 39599 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 39600 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 39601 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 39602 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 39603 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 39604 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 39605 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 39606 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 39607 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 39608 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 39609 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 39610 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 39611 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 39612 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 39613 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 39614 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 39615 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 39616 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 39617 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 39618 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 39619 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 39620 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 39621 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 39622 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 39623 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 39624 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 39625 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 39626 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 39627 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 39628 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 39629 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 39630 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 39631 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 39632 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 39633 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 39634 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 39635 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 39636 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 39637 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 39638 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 39639 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 39640 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 39641 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 39642 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 39643 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 39644 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 39645 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 39646 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 39647 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 39648 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 39649 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 39650 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 39651 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 39652 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 39653 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 39654 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 39655 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 39656 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 39657 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 39658 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 39659 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 39660 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 39661 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 39662 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 39663 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 39664 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 39665 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 39666 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 39667 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 39668 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 39669 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 39670 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 39671 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 39672 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 39673 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 39674 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 39675 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 39676 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 39677 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 39678 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 39679 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 39680 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 39681 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 39682 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 39683 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 39684 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 39685 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 39686 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 39687 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 39688 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 39689 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 39690 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 39691 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 39692 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 39693 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 39694 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 39695 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 39696 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 39697 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 39698 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 39699 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 39700 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 39701 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 39702 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 39703 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 39704 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 39705 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 39706 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 39707 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 39708 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 39709 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 39710 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 39711 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 39712 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 39713 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 39714 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 39715 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 39716 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 39717 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 39718 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 39719 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 39720 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 39721 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 39722 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 39723 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 39724 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 39725 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 39726 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 39727 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 39728 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 39729 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 39730 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 39731 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 39732 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 39733 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 39734 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 39735 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 39736 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 39737 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 39738 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 39739 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 39740 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 39741 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 39742 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 39743 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 39744 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 39745 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 39746 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 39747 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 39748 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 39749 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 39750 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 39751 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 39752 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 39753 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 39754 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 39755 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 39756 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 39757 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 39758 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 39759 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 39760 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 39761 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 39762 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 39763 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 39764 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 39765 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 39766 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 39767 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 39768 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 39769 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 39770 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 39771 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 39772 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 39773 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 39774 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 39775 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 39776 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 39777 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 39778 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 39779 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 39780 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 39781 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 39782 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 39783 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 39784 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 39785 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 39786 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 39787 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 39788 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 39789 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 39790 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 39791 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 39792 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 39793 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 39794 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 39795 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 39796 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 39797 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 39798 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 39799 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 39800 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 39801 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 39802 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 39803 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 39804 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 39805 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 39806 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 39807 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 39808 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 39809 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 39810 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 39811 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 39812 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 39813 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 39814 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 39815 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 39816 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 39817 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 39818 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 39819 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 39820 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 39821 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 39822 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 39823 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 39824 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 39825 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 39826 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 39827 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 39828 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 39829 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 39830 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 39831 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 39832 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 39833 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 39834 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 39835 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 39836 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 39837 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 39838 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 39839 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 39840 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 39841 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 39842 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 39843 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 39844 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 39845 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 39846 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 39847 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 39848 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 39849 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 39850 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 39851 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 39852 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 39853 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 39854 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 39855 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 39856 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 39857 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 39858 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 39859 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 39860 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 39861 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 39862 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 39863 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 39864 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 39865 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 39866 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 39867 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 39868 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 39869 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 39870 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 39871 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 39872 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 39873 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 39874 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 39875 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 39876 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 39877 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 39878 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 39879 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 39880 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 39881 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 39882 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 39883 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 39884 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 39885 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 39886 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 39887 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 39888 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 39889 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 39890 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 39891 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 39892 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 39893 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 39894 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 39895 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 39896 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 39897 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 39898 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 39899 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 39900 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 39901 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 39902 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 39903 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 39904 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 39905 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 39906 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 39907 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 39908 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 39909 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 39910 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 39911 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 39912 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 39913 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 39914 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 39915 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 39916 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 39917 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 39918 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 39919 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 39920 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 39921 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 39922 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 39923 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 39924 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 39925 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 39926 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 39927 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 39928 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 39929 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 39930 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 39931 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 39932 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 39933 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 39934 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 39935 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 39936 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 39937 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 39938 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 39939 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 39940 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 39941 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 39942 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 39943 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 39944 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 39945 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 39946 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 39947 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 39948 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 39949 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 39950 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 39951 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 39952 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 39953 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 39954 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 39955 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 39956 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 39957 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 39958 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 39959 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 39960 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 39961 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 39962 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 39963 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 39964 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 39965 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 39966 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 39967 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 39968 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 39969 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 39970 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 39971 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 39972 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 39973 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 39974 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 39975 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 39976 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 39977 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 39978 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 39979 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 39980 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 39981 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 39982 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 39983 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 39984 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 39985 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 39986 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 39987 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 39988 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 39989 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 39990 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 39991 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 39992 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 39993 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 39994 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 39995 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 39996 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 39997 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 39998 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 39999 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 40000 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 40001 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 40002 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 40003 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 40004 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 40005 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 40006 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 40007 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 40008 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 40009 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 40010 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 40011 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 40012 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 40013 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 40014 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 40015 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 40016 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 40017 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 40018 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 40019 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 40020 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 40021 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 40022 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 40023 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 40024 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 40025 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 40026 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 40027 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 40028 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 40029 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 40030 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 40031 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 40032 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 40033 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 40034 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 40035 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 40036 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 40037 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 40038 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 40039 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 40040 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 40041 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 40042 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 40043 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 40044 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 40045 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 40046 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 40047 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 40048 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 40049 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 40050 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 40051 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 40052 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 40053 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 40054 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 40055 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 40056 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 40057 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 40058 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 40059 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 40060 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 40061 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 40062 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 40063 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 40064 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 40065 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 40066 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 40067 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 40068 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 40069 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 40070 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 40071 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 40072 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 40073 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 40074 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 40075 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 40076 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 40077 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 40078 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 40079 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 40080 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 40081 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 40082 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 40083 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 40084 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 40085 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 40086 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 40087 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 40088 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 40089 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 40090 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 40091 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 40092 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 40093 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 40094 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 40095 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 40096 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 40097 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 40098 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 40099 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 40100 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 40101 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 40102 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 40103 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 40104 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 40105 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 40106 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 40107 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 40108 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 40109 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 40110 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 40111 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 40112 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 40113 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 40114 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 40115 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 40116 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 40117 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 40118 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 40119 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 40120 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 40121 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 40122 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 40123 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 40124 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 40125 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 40126 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 40127 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 40128 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 40129 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 40130 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 40131 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 40132 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 40133 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 40134 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 40135 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 40136 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 40137 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 40138 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 40139 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 40140 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 40141 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 40142 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 40143 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 40144 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 40145 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 40146 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 40147 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 40148 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 40149 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 40150 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 40151 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 40152 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 40153 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 40154 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 40155 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 40156 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 40157 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 40158 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 40159 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 40160 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 40161 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 40162 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 40163 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 40164 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 40165 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 40166 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 40167 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 40168 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 40169 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 40170 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 40171 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 40172 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 40173 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 40174 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 40175 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 40176 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 40177 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 40178 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 40179 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 40180 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 40181 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 40182 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 40183 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 40184 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 40185 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 40186 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 40187 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 40188 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 40189 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 40190 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 40191 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 40192 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 40193 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 40194 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 40195 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 40196 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 40197 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 40198 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 40199 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 40200 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 40201 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 40202 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 40203 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 40204 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 40205 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 40206 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 40207 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 40208 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 40209 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 40210 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 40211 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 40212 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 40213 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 40214 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 40215 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 40216 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 40217 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 40218 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 40219 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 40220 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 40221 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 40222 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 40223 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 40224 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 40225 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 40226 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 40227 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 40228 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 40229 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 40230 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 40231 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 40232 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 40233 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 40234 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 40235 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 40236 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 40237 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 40238 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 40239 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 40240 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 40241 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 40242 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 40243 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 40244 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 40245 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 40246 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 40247 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 40248 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 40249 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 40250 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 40251 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 40252 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 40253 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 40254 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 40255 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 40256 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 40257 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 40258 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 40259 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 40260 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 40261 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 40262 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 40263 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 40264 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 40265 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 40266 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 40267 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 40268 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 40269 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 40270 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 40271 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 40272 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 40273 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 40274 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 40275 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 40276 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 40277 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 40278 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 40279 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 40280 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 40281 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 40282 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 40283 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 40284 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 40285 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 40286 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 40287 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 40288 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 40289 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 40290 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 40291 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 40292 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 40293 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 40294 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 40295 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 40296 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 40297 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 40298 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 40299 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 40300 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 40301 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 40302 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 40303 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 40304 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 40305 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 40306 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 40307 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 40308 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 40309 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 40310 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 40311 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 40312 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 40313 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 40314 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 40315 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 40316 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 40317 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 40318 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 40319 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 40320 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 40321 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 40322 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 40323 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 40324 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 40325 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 40326 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 40327 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 40328 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 40329 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 40330 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 40331 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 40332 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 40333 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 40334 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 40335 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 40336 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 40337 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 40338 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 40339 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 40340 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 40341 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 40342 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 40343 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 40344 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 40345 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 40346 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 40347 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 40348 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 40349 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 40350 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 40351 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 40352 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 40353 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 40354 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 40355 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 40356 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 40357 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 40358 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 40359 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 40360 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 40361 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 40362 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 40363 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 40364 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 40365 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 40366 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 40367 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 40368 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 40369 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 40370 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 40371 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 40372 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 40373 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 40374 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 40375 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 40376 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 40377 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 40378 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 40379 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 40380 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 40381 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 40382 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 40383 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 40384 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 40385 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 40386 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 40387 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 40388 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 40389 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 40390 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 40391 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 40392 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 40393 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 40394 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 40395 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 40396 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 40397 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 40398 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 40399 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 40400 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 40401 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 40402 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 40403 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 40404 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 40405 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 40406 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 40407 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 40408 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 40409 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 40410 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 40411 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 40412 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 40413 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 40414 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 40415 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 40416 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 40417 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 40418 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 40419 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 40420 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 40421 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 40422 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 40423 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 40424 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 40425 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 40426 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 40427 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 40428 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 40429 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 40430 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 40431 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 40432 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 40433 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 40434 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 40435 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 40436 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 40437 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 40438 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 40439 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 40440 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 40441 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 40442 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 40443 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 40444 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 40445 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 40446 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 40447 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 40448 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 40449 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 40450 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 40451 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 40452 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 40453 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 40454 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 40455 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 40456 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 40457 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 40458 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 40459 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 40460 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 40461 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 40462 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 40463 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 40464 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 40465 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 40466 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 40467 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 40468 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 40469 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 40470 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 40471 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 40472 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 40473 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 40474 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 40475 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 40476 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 40477 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 40478 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 40479 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 40480 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 40481 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 40482 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 40483 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 40484 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 40485 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 40486 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 40487 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 40488 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 40489 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 40490 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 40491 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 40492 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 40493 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 40494 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 40495 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 40496 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 40497 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 40498 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 40499 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 40500 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 40501 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 40502 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 40503 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 40504 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 40505 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 40506 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 40507 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 40508 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 40509 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 40510 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 40511 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 40512 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 40513 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 40514 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 40515 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 40516 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 40517 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 40518 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 40519 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 40520 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 40521 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 40522 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 40523 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 40524 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 40525 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 40526 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 40527 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 40528 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 40529 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 40530 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 40531 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 40532 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 40533 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 40534 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 40535 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 40536 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 40537 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 40538 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 40539 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 40540 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 40541 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 40542 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 40543 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 40544 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 40545 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 40546 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 40547 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 40548 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 40549 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 40550 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 40551 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 40552 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 40553 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 40554 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 40555 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 40556 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 40557 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 40558 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 40559 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 40560 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 40561 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 40562 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 40563 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 40564 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 40565 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 40566 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 40567 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 40568 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 40569 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 40570 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 40571 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 40572 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 40573 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 40574 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 40575 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 40576 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 40577 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 40578 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 40579 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 40580 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 40581 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 40582 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 40583 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 40584 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 40585 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 40586 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 40587 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 40588 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 40589 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 40590 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 40591 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 40592 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 40593 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 40594 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 40595 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 40596 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 40597 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 40598 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 40599 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 40600 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 40601 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 40602 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 40603 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 40604 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 40605 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 40606 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 40607 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 40608 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 40609 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 40610 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 40611 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 40612 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 40613 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 40614 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 40615 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 40616 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 40617 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 40618 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 40619 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 40620 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 40621 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 40622 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 40623 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 40624 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 40625 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 40626 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 40627 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 40628 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 40629 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 40630 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 40631 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 40632 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 40633 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 40634 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 40635 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 40636 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 40637 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 40638 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 40639 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 40640 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 40641 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 40642 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 40643 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 40644 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 40645 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 40646 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 40647 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 40648 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 40649 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 40650 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 40651 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 40652 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 40653 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 40654 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 40655 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 40656 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 40657 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 40658 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 40659 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 40660 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 40661 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 40662 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 40663 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 40664 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 40665 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 40666 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 40667 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 40668 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 40669 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 40670 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 40671 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 40672 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 40673 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 40674 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 40675 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 40676 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 40677 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 40678 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 40679 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 40680 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 40681 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 40682 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 40683 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 40684 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 40685 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 40686 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 40687 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 40688 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 40689 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 40690 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 40691 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 40692 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 40693 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 40694 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 40695 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 40696 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 40697 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 40698 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 40699 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 40700 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 40701 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 40702 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 40703 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 40704 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 40705 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 40706 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 40707 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 40708 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 40709 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 40710 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 40711 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 40712 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 40713 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 40714 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 40715 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 40716 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 40717 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 40718 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 40719 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 40720 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 40721 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 40722 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 40723 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 40724 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 40725 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 40726 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 40727 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 40728 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 40729 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 40730 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 40731 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 40732 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 40733 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 40734 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 40735 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 40736 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 40737 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 40738 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 40739 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 40740 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 40741 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 40742 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 40743 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 40744 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 40745 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 40746 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 40747 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 40748 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 40749 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 40750 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 40751 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 40752 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 40753 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 40754 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 40755 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 40756 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 40757 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 40758 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 40759 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 40760 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 40761 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 40762 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 40763 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 40764 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 40765 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 40766 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 40767 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 40768 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 40769 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 40770 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 40771 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 40772 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 40773 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 40774 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 40775 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 40776 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 40777 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 40778 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 40779 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 40780 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 40781 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 40782 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 40783 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 40784 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 40785 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 40786 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 40787 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 40788 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 40789 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 40790 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 40791 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 40792 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 40793 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 40794 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 40795 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 40796 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 40797 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 40798 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 40799 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 40800 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 40801 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 40802 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 40803 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 40804 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 40805 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 40806 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 40807 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 40808 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 40809 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 40810 - protein, 189 aa, Artificial Sequence
  Artificially synthesized modified ADAM10 peptide
NPLNKYIRHYEGLSYNVDSLHQKHQRAKAAVSHADQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK
